United States Patent 11,931,406 (FLAVIVIRUS VACCINE) - sequence listing, part 30

SEQ ID NO: 12216 - RNA, 9876 nt, Artificial Sequence
  derived and/or modified CDS sequence (opt2) from DENV-2__EU482671__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucguccgcgagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12217 - RNA, 9876 nt, Artificial Sequence
  derived and/or modified CDS sequence (opt2) from DENV-2__EU482674__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggccacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaagaacaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagaagcccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12218 - RNA, 9876 nt, Artificial Sequence
  derived and/or modified CDS sequence (opt2) from DENV-2__EU482676__SS-prME
uccgccuccaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucaaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggccgcaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagaucgagcgcgccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccuccgcaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12219 - RNA, 9876 nt, Artificial Sequence
  derived and/or modified CDS sequence (opt2) from DENV-2__EU482677__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagaccaagaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaacgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12220 - RNA, 9876 nt, Artificial Sequence
  derived and/or modified CDS sequence (opt2) from DENV-2__EU482678__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacgagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucgccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12221 - RNA, 9876 nt, Artificial Sequence
  derived and/or modified CDS sequence (opt2) from DENV-2__EU482679__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugggcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12222 - RNA, 9876 nt, Artificial Sequence
  derived and/or modified CDS sequence (opt2) from DENV-2__EU482774__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagaucuucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucguccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12223 - RNA, 9876 nt, Artificial Sequence
  derived and/or modified CDS sequence (opt2) from DENV-2__EU482775__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12224 - RNA, 9876 nt, Artificial Sequence
  derived and/or modified CDS sequence (opt2) from DENV-2__EU482776__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuacaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggccuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcauccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggcugcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccucgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12225 - RNA, 9876 nt, Artificial Sequence
  derived and/or modified CDS sequence (opt2) from DENV-2__EU482777__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12226 - RNA, 9876 nt, Artificial Sequence
  derived and/or modified CDS sequence (opt2) from DENV-2__EU482778__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaagaacugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaucggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccguccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12227 - RNA, 9876 nt, Artificial Sequence
  derived and/or modified CDS sequence (opt2) from DENV-2__EU482779__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12228 - RNA, 9876 nt, Artificial Sequence
  derived and/or modified CDS sequence (opt2) from DENV-2__EU482780__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcaugcucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12229 - RNA, 9876 nt, Artificial Sequence
  derived and/or modified CDS sequence (opt2) from DENV-2__EU482781__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcagcccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucuggaagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12230 - RNA, 9876 nt, Artificial Sequence
  derived and/or modified CDS sequence (opt2) from DENV-2__EU482782__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgucgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12231 - RNA, 9876 nt, Artificial Sequence
  derived and/or modified CDS sequence (opt2) from DENV-2__EU482783__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcggcaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12232 - RNA, 9876 nt, Artificial Sequence
  derived and/or modified CDS sequence (opt2) from DENV-2__EU482784__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12233 - RNA, 9876 nt, Artificial Sequence
  derived and/or modified CDS sequence (opt2) from DENV-2__EU482785__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12234 - RNA, 9876 nt, Artificial Sequence
  derived and/or modified CDS sequence (opt2) from DENV-2__EU482786__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucguccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacggcgacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12235 - RNA, 9876 nt, Artificial Sequence
  derived and/or modified CDS sequence (opt2) from DENV-2__EU482787__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12236 - RNA, 9876 nt, Artificial Sequence
  derived and/or modified CDS sequence (opt2) from DENV-2__EU482788__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12237 - RNA, 9876 nt, Artificial Sequence
  derived and/or modified CDS sequence (opt2) from DENV-2__EU482697__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuaccgcgagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaccgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaacuuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12238 - RNA, 9876 nt, Artificial Sequence
  derived and/or modified CDS sequence (opt2) from DENV-2__EU482699__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcauccucggcauggcccucuuccucgaggagaugcuccgcacccgcgucggcaccaagcacgccauccuccucgccgccgucuccuucgucacccucaucaccggcaacauguccuucaaggaccucggccgcgucauggucauggucggcgccaccauggccgacgacaucggcaugggcgucaccuaccucgcccuccucgccgccuucaagguccgccccaccuucgccgccggccuccuccuccgccgccucaccuccaaggagcucaugaugaccaccaucggcaucguccuccucucccaguccaccauccccgagaccguccucgagcucaccgacgcccucgcccucggcaugaugguccucaagaucguccgcaagauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaagggcggcgagaagaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12239 - RNA, 9876 nt, Artificial Sequence
  derived and/or modified CDS sequence (opt2) from DENV-2__EU482701__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacgccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccucaaggagaagcaggacgccuucugcgacuccaagcucauguccgccgccgucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagauggucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcauccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcgucguccuccucucccaguccaccauccccgacaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12240 - RNA, 9876 nt, Artificial Sequence
  derived and/or modified CDS sequence (opt2) from DENV-2__EU482703__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucggcugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12241 - RNA, 9876 nt, Artificial Sequence
  derived and/or modified CDS sequence (opt2) from DENV-2__EU482705__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacaacaucggcaugggcgucaccuaccucgcccuccucgccgccuucaagguccgccccaccuucgccgccggccuccuccuccgccgccucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12242 - RNA, 9876 nt, Artificial Sequence
  derived and/or modified CDS sequence (opt2) from DENV-2__EU482463__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagaagcccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12243 - RNA, 9876 nt, Artificial Sequence
  derived and/or modified CDS sequence (opt2) from DENV-2__EU482464__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcaccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucgccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12244 - RNA, 9876 nt, Artificial Sequence
  derived and/or modified CDS sequence (opt2) from DENV-2__EU482465__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaccgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaccaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12245 - RNA, 9876 nt, Artificial Sequence
  derived and/or modified CDS sequence (opt2) from DENV-2__EU482466__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccuccccccuccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12246 - RNA, 9876 nt, Artificial Sequence
  derived and/or modified CDS sequence (opt2) from DENV-2__EU482467__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccaccaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12247 - RNA, 9876 nt, Artificial Sequence
  derived and/or modified CDS sequence (opt2) from DENV-2__EU482468__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggaucaugcgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggauggaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccacccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12248 - RNA, 9876 nt, Artificial Sequence
  derived and/or modified CDS sequence (opt2) from DENV-2__EU482469__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgcccacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaagaacaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12249 - RNA, 9876 nt, Artificial Sequence
  derived and/or modified CDS sequence (opt2) from DENV-2__EU482470__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccgccagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12250 - RNA, 9876 nt, Artificial Sequence
  derived and/or modified CDS sequence (opt2) from DENV-2__EU482471__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacuccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccaacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12251 - RNA, 9876 nt, Artificial Sequence
  derived and/or modified CDS sequence (opt2) from DENV-2__EU482472__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggauggaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaucaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12252 - RNA, 9876 nt, Artificial Sequence
  derived and/or modified CDS sequence (opt2) from DENV-2__EU482473__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggucgccaucaaccagguccgcucccucaucggcaacgaggaguacaccgacuacaugcccuccaugaagcgcuuccgccgcgaggaggaggaggccggcguccucugguga

SEQ ID NO: 12253 - RNA, 9876 nt, Artificial Sequence
  derived and/or modified CDS sequence (opt2) from DENV-2__EU482474__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccaucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12254 - RNA, 9876 nt, Artificial Sequence
  derived and/or modified CDS sequence (opt2) from DENV-2__EU482475__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgucgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12255 - RNA, 9876 nt, Artificial Sequence
  derived and/or modified CDS sequence (opt2) from DENV-2__EU482541__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccgccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcgccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12256 - RNA, 9876 nt, Artificial Sequence
  derived and/or modified CDS sequence (opt2) from DENV-2__EU482542__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagguccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaccugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcucaagacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12257 - RNA, 9876 nt, Artificial Sequence
  derived and/or modified CDS sequence (opt2) from DENV-2__JX966380__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagaugaaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucaccuccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagacccucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagauggucauccccaagaacuucgccggccccgucucccagcacaacaaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucaccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggcaacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucgucccccccgagaagugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaagaacauccagcaccucaccgccuccgaggagaucgccguccaggacuggcucguccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaacaaggucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12258 - RNA, 9876 nt, Artificial Sequence
  derived and/or modified CDS sequence (opt2) from DENV-2__JX966379__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcggcaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccucccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagauggucauccccaagaacuacgccggccccgucucccagcacaacaaccgccccggcuaccacacccagaccgccggccccuggcaccucggcaagcucgagauggacuucgacuucugcgagggcaccaccgucgucgucaccgaggagugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcucccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuacaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccacccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccaccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccuccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggccacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucgucccccccgagaagugcgacacccuccucugcgacaucggcgaguccucccccaaccccaccgucgaggccggccgcacccuccgcguccucaaccucgucgagaacuggcucaacgacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacgucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcgucuacaacaugaugggcaagcgcgagaagaagcucggcgaguucggcaaggcccgcggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcaucuucaaguccauccagcaccucaccgccuccgaggagaucgccguccaggacuggcucgcccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12259 - RNA, 9876 nt, Artificial Sequence
  derived and/or modified CDS sequence (opt2) from DENV-2__KP012546__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccaugcccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucuccacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaccaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggaaccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12260 - RNA, 9876 nt, Artificial Sequence
  derived and/or modified CDS sequence (opt2) from DENV-2__KP723478__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccaugucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccaugcccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccacccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucuccacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaccaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggaaccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12261 - RNA, 9876 nt, Artificial Sequence
  derived and/or modified CDS sequence (opt2) from DENV-2__KP723479__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagaugaaggagcgccaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaggccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucgucuccggccucuuccccgucuccacccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgagaacaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12262 - RNA, 9876 nt, Artificial Sequence
  derived and/or modified CDS sequence (opt2) from DENV-2__KT187554__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccaugcccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccucuuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucuccacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaccaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagcgcgagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggaaccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12263 - RNA, 9876 nt, Artificial Sequence
  derived and/or modified CDS sequence (opt2) from DENV-2__KT187557__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccaugucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccaugcccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucuccacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaccaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggaaccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12264 - RNA, 9876 nt, Artificial Sequence
  derived and/or modified CDS sequence (opt2) from DENV-2__JQ045670__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccgccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacgaccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12265 - RNA, 9876 nt, Artificial Sequence
  derived and/or modified CDS sequence (opt2) from DENV-2__JQ045686__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgucauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggccaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaucaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucaacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgucggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcgucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12266 - RNA, 9876 nt, Artificial Sequence
  derived and/or modified CDS sequence (opt2) from DENV-2__KU094070__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgaguggcucgaggacaagaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcuccaucgucaccugcgccauguucaccugcaagaagaucaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcuaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaccggcgucaucaucaccuggaucggcaugaacucccgcuccaccucccucuccgucucccucguccucgucggcgccgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgaggagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucacccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgucaccuggggcaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12267 - RNA, 9876 nt, Artificial Sequence
  derived and/or modified CDS sequence (opt2) from DENV-2__FM210215__SS-prME
uccgccggcaugaucgucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucguccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacucccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaguccguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12268 - RNA, 9876 nt, Artificial Sequence
  derived and/or modified CDS sequence (opt2) from DENV-2__FM210216__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12269 - RNA, 9876 nt, Artificial Sequence
  derived and/or modified CDS sequence (opt2) from DENV-2__FM210217__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgaccaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaucggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcuccaaggaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12270 - RNA, 9876 nt, Artificial Sequence
  derived and/or modified CDS sequence (opt2) from DENV-2__JX286524__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 12271 - RNA, 9876 nt, Artificial Sequence
  derived and/or modified CDS sequence (opt2) from DENV-2__JX286520__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaucgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 12272 - RNA, 9876 nt, Artificial Sequence
  derived and/or modified CDS sequence (opt2) from DENV-2__JX286525__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 12273 - RNA, 9876 nt, Artificial Sequence
  derived and/or modified CDS sequence (opt2) from DENV-2__KM279598__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgacgucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12274 - RNA, 9876 nt, Artificial Sequence
  derived and/or modified CDS sequence (opt2) from DENV-2__KM279576__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaccuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12275 - RNA, 9876 nt, Artificial Sequence
  derived and/or modified CDS sequence (opt2) from DENV-2__KC964095__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgaccgcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgccccccccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccaucgucgaccgcggcuggggcaacggcugcggcuccuucggcaagggcggcaucgucaccugcgccauguucaccugcaagaagaacauggagggcaagaucguccagcccgagaaccucgaguacaccaucgucgucaccccccacuccggcgaggagcacgccaucggcaacgacaccggcaagcacggcaaggagaucaaggucaccccccaguccuccgucaccgaggccgagcucaccggcuacggcaccgucaccaucgagugcuccccccgcaccggccucgacuucaacgagaugguccuccuccagaugggcaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugcggccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccgcaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaccaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcauguucaccaccaacaucuggcuccagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccagggcaagcccgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugauggcccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaacugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcguccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucggcggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgagggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccucccccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguggucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucggcaagaucaagcaggagcacgagaccuccuggcacuacgaccaggaccaccccuacaagaccugggccuaccacggcuccuacgagaccaagcagaccggcuccgccuccuccauggucgacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaaggagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgcccccccccccgcggcaccgucauggacaucaucucccgccgcgaccagcgcggcuccggccaggucgucaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacgucggcaagauccgcaaggacauccagcagugggagcccucccgcggcugggacgacuggacccagguccccuucugcucccaccacucccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgagggccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12276 - RNA, 9876 nt, Artificial Sequence
  derived and/or modified CDS sequence (opt2) from DENV-2__KC964094__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcuccaucggcaucuccaaccgcgacuucgucgagggcgucuccggcggcuccugggucgacgucguccucgagcacggcuccugcgucaccaccauggccaagaacaagcccacccucgacuucgagcucaccaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccgucaccgaggccgagcucaccggcuacggcaccgucaccauggagugcuccccccgcaccggccucgacuucaacgagaugguccuccuccagaugaagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcaccgacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaaggaguccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagcgccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucgccggccgcuccgccgaccucgagcucgagcgcgccgccgacguccgcugggaggagcaggccgagaucuccggcuccucccccauccucuccaucaccaucuccgaggacggcggcauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagauccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaccuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggccgcaaggucauccagcucucccgcaagaccuccgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucgucggcaacccccucucccgcaacuccacccacgagauguacugggccuccaacgccuccggcaacaucgucuccuccgucaacaugaucucccgcaugcucaucaaccgcuucaccaugcgccacaagaaggccaccuacgagcccgacgucgaccucggcuccggcacccgccacaucggcaucgaguccgagacccccaaccucgacaucaucggcaagcgcaucgagaagaucaagcaggagcacgagaccuccuggcacugcgaccaggaccaccccuacaagaccugggccuaccacggcuccuacgaggccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaaggccccccgcaugugcacccgcgaggaguucacccgcaagguccgcuccaacgccgcccucggcgccauguucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12277 - RNA, 9876 nt, Artificial Sequence
  derived and/or modified CDS sequence (opt2) from DENV-2__KC964093__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaccaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgucgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggccgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccucccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucgccggccgcuccgccgaccucgagcucgagcgcgccgccgacguccgcugggaggagcaggccgagaucuccggcuccucccccauccucuccaucaccaucuccgaggacggcggcauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagauccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagcgcgucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacgaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgccaucgccauccucaccgucgucgccgccaccauggccaacgagaugggcuuccucgagaagaccaagaaggacuucggccucggcuccaucgccacccagcagcccgaguccaacauccucgaccucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgucggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucgccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucacccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggagggcgaggccggcguccucugguga

SEQ ID NO: 12278 - RNA, 9876 nt, Artificial Sequence
  derived and/or modified CDS sequence (opt2) from DENV-2__DQ448231__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacaccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagauccucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 12279 - RNA, 9876 nt, Artificial Sequence
  derived and/or modified CDS sequence (opt2) from DENV-2__JX470186__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucgcccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagaugaaggagcgccaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaggccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucgucuccggccucuuccccgucuccacccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgagaacaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12280 - RNA, 9876 nt, Artificial Sequence
  derived and/or modified CDS sequence (opt2) from DENV-2__KU517846__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucaugacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcucacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucucccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12281 - RNA, 9876 nt, Artificial Sequence
  derived and/or modified CDS sequence (opt2) from DENV-2__KJ830750__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgaguccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccauccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccggccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuuccgccgcgaggaggaggaggccggcguccucugguga

SEQ ID NO: 12282 - RNA, 9876 nt, Artificial Sequence
  derived and/or modified CDS sequence (opt2) from DENV-2__FM210231__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucguccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgucacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaguccguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12283 - RNA, 9876 nt, Artificial Sequence
  derived and/or modified CDS sequence (opt2) from DENV-2__FM210239__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgccgcaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12284 - RNA, 9876 nt, Artificial Sequence
  derived and/or modified CDS sequence (opt2) from DENV-2__FM210232__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggccugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12285 - RNA, 9876 nt, Artificial Sequence
  derived and/or modified CDS sequence (opt2) from DENV-2__FM210233__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggauggaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagcgcgaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12286 - RNA, 9876 nt, Artificial Sequence
  derived and/or modified CDS sequence (opt2) from DENV-2__FM210241__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccucucccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccaguucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12287 - RNA, 9876 nt, Artificial Sequence
  derived and/or modified CDS sequence (opt2) from DENV-2__FM210242__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucguccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaguccguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12288 - RNA, 9876 nt, Artificial Sequence
  derived and/or modified CDS sequence (opt2) from DENV-2__FM210243__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuucccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12289 - RNA, 9876 nt, Artificial Sequence
  derived and/or modified CDS sequence (opt2) from DENV-2__FM210244__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaucggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcuccaaggaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagaugcccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12290 - RNA, 9876 nt, Artificial Sequence
  derived and/or modified CDS sequence (opt2) from DENV-2__FM210234__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcaucgcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12291 - RNA, 9876 nt, Artificial Sequence
  derived and/or modified CDS sequence (opt2) from DENV-2__FM210213__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12292 - RNA, 9876 nt, Artificial Sequence
  derived and/or modified CDS sequence (opt2) from DENV-2__FM210235__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugccgccacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgagugguccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccgcgagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12293 - RNA, 9876 nt, Artificial Sequence
  derived and/or modified CDS sequence (opt2) from DENV-2__FM210205__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccucaagaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12294 - RNA, 9876 nt, Artificial Sequence
  derived and/or modified CDS sequence (opt2) from DENV-2__FM210206__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaucgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12295 - RNA, 9876 nt, Artificial Sequence
  derived and/or modified CDS sequence (opt2) from DENV-2__FM210246__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuucaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12296 - RNA, 9876 nt, Artificial Sequence
  derived and/or modified CDS sequence (opt2) from DENV-2__FM210207__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaagaacgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccaugcacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12297 - RNA, 9876 nt, Artificial Sequence
  derived and/or modified CDS sequence (opt2) from DENV-2__FM210238__SS-prME
accgccggcaugaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacgaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12298 - RNA, 9876 nt, Artificial Sequence
  derived and/or modified CDS sequence (opt2) from DENV-2__FM210224__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgccaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12299 - RNA, 9876 nt, Artificial Sequence
  derived and/or modified CDS sequence (opt2) from DENV-2__FM210225__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12300 - RNA, 9876 nt, Artificial Sequence
  derived and/or modified CDS sequence (opt2) from DENV-2__FM210226__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccgccaugaccgacgacaucggcaucggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccaccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccguccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12301 - RNA, 9876 nt, Artificial Sequence
  derived and/or modified CDS sequence (opt2) from DENV-2__FM210227__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccgucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccacccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugauccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuucggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccgucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugggcggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgaccucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12302 - RNA, 9876 nt, Artificial Sequence
  derived and/or modified CDS sequence (opt2) from DENV-2__FM210204__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccgucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgccaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggccuacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccucgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccgucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugccccccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgaccucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12303 - RNA, 9876 nt, Artificial Sequence
  derived and/or modified CDS sequence (opt2) from DENV-2__FM210230__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccacccacuuccagcgcgcccucaucuucauccuccucgccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccagucccccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucaccgucuccuucgucacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucucccccaugcuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucgccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcgucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaucugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaagggcggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcgccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12304 - RNA, 9876 nt, Artificial Sequence
  derived and/or modified CDS sequence (opt2) from DENV-2__KC762665__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucgcccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12305 - RNA, 9876 nt, Artificial Sequence
  derived and/or modified CDS sequence (opt2) from DENV-2__KC762669__SS-prME
accgccggcaucaucaucauggucauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaucaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcucgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12306 - RNA, 9876 nt, Artificial Sequence
  derived and/or modified CDS sequence (opt2) from DENV-2__KC762658__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgcccccggcgagcaccgccgcgagaagcgcuccgucgcccucgucccccacgucggcaugggccucgagacccgcaccgagaccuggauguccuccgagggcgccggcaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcuccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgagcucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgagaaguacaccgacuacaugcccuccaugaagcgcuuccgccgcgaggaggaggaggccggcguccucugguga

SEQ ID NO: 12307 - RNA, 9876 nt, Artificial Sequence
  derived and/or modified CDS sequence (opt2) from DENV-2__KC762660__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaucgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12308 - RNA, 9876 nt, Artificial Sequence
  derived and/or modified CDS sequence (opt2) from DENV-2__KC762676__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuacugcgacuccaagcucauguccgccgccaucaaggacaaccgcgccguccacgccgacaugggcuacuggaucgaguccgcccucaacgacaccuggaagaucgagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugauggcccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucucccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuaccgcaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccaacgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12309 - RNA, 9876 nt, Artificial Sequence
  derived and/or modified CDS sequence (opt2) from DENV-2__KC762662__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgucaccgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12310 - RNA, 9876 nt, Artificial Sequence
  derived and/or modified CDS sequence (opt2) from DENV-2__KC762661__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccagacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12311 - RNA, 9876 nt, Artificial Sequence
  derived and/or modified CDS sequence (opt2) from DENV-2__KC762655__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccgucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaacaaggccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccaccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcucccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaucgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12312 - RNA, 9876 nt, Artificial Sequence
  derived and/or modified CDS sequence (opt2) from DENV-2__KC762656__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcgccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcaccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccaguggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucgucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12313 - RNA, 9876 nt, Artificial Sequence
  derived and/or modified CDS sequence (opt2) from DENV-2__KC762673__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccccccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuacugcgacuccaagcucauguccgccgccaucaaggacaaccgcgccguccacgccgacaugggcuacuggaucgaguccgcccucaacgacaccuggaagaucgagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugauggcccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuaccgcaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12314 - RNA, 9876 nt, Artificial Sequence
  derived and/or modified CDS sequence (opt2) from DENV-2__KC762663__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgucaccgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12315 - RNA, 9876 nt, Artificial Sequence
  derived and/or modified CDS sequence (opt2) from DENV-2__KC762675__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuacugcgacuccaagcucauguccgccgccaucaaggacaaccgcgccguccacgccgacaugggcuacuggaucgaguccgcccucaacgacaccuggaagaucgagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugauggcccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagauccagcaggagcacgagaccuccuggcacuacgaccaggaccaccccuaccgcaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaaggaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12316 - RNA, 9876 nt, Artificial Sequence
  derived and/or modified CDS sequence (opt2) from DENV-2__KC762671__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaggccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaugaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12317 - RNA, 9876 nt, Artificial Sequence
  derived and/or modified CDS sequence (opt2) from DENV-2__KC762664__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucaccgaccucgagaagcgccacggccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcaaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgucaccgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucggcuccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12318 - RNA, 9876 nt, Artificial Sequence
  derived and/or modified CDS sequence (opt2) from DENV-2__KC762674__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuacugcgacuccaagcucauguccgccgccaucaaggacaaccgcgccguccacgccgacaugggcuacuggaucgaguccgcccucaacgacaccuggaagaucgagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugauggcccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12319 - RNA, 9876 nt, Artificial Sequence
  derived and/or modified CDS sequence (opt2) from DENV-2__KC762672__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccugggagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaggccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacgccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaugaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12320 - RNA, 9876 nt, Artificial Sequence
  derived and/or modified CDS sequence (opt2) from DENV-2__KC762667__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcgucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcgcgagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12321 - RNA, 9876 nt, Artificial Sequence
  derived and/or modified CDS sequence (opt2) from DENV-2__KC762659__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggauggaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgccgccucaccuccaaggagcucaugaugaccaccaucggcaucguccuccucucccaguccaccauccccgagaccauccucgagcucaccgacgcccucgcccucggcaugaugguccucaagaucguccgcaagauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcaguccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12322 - RNA, 9876 nt, Artificial Sequence
  derived and/or modified CDS sequence (opt2) from DENV-2__KC762657__SS-prME
accgccggcaucaucaucaugaugauccccaccgucauggucuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggauggaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgccgccucaccuccaaggagcucaugaugaccaccaucggcaucguccuccucucccaguccaccauccccgagaccauccucgagcucaccgacgcccucgcccucggcaugaugguccucaagaucguccgcaagauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcaguccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgccaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12323 - RNA, 9876 nt, Artificial Sequence
  derived and/or modified CDS sequence (opt2) from DENV-2__KC762666__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcgcgagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12324 - RNA, 9876 nt, Artificial Sequence
  derived and/or modified CDS sequence (opt2) from DENV-2__KC762677__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuacugcgacuccaagcucauguccgccgccaucaaggacaaccgcgccguccacgccgacaugggcuacuggaucgaguccgcccucaacgacaccuggaagaucgagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgccccaugaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugauggcccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuaccgcaccugggccuaccacggcuccuacgagaacaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcaaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12325 - RNA, 9876 nt, Artificial Sequence
  derived and/or modified CDS sequence (opt2) from DENV-2__KC762668__SS-prME
accgccggcaucaucaucauggucauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaucaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcucgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagcgccucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12326 - RNA, 9876 nt, Artificial Sequence
  derived and/or modified CDS sequence (opt2) from DENV-2__KC762678__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcauccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacgccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaucggcgucaccuaccucgcccuccucgccgccuucaagguccgccccaccuucgccgccggccuccuccuccgcaagcucaccuccaaggagcucaugaugaccaccaucggcaucacccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccuccaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagguccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucucccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgucaccgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12327 - RNA, 9876 nt, Artificial Sequence
  derived and/or modified CDS sequence (opt2) from DENV-2__KC762679__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaggccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaugaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12328 - RNA, 9876 nt, Artificial Sequence
  derived and/or modified CDS sequence (opt2) from DENV-2__KC762680__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacucccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaggccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuucgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaugaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaagggcaacgaggaguacaccgacuacaugcccuccaugaagcgcuuccgccgcgaggagggcgaggccggcguccucugguga

SEQ ID NO: 12329 - RNA, 9876 nt, Artificial Sequence
  derived and/or modified CDS sequence (opt2) from DENV-2__JQ955624__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucgccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccaccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccgucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcauccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccaguccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgagcucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggcuucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaugggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaaguccauccagcaccucaccaccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 12330 - RNA, 9876 nt, Artificial Sequence
  derived and/or modified CDS sequence (opt2) from DENV-2__KJ918750__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaucuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaucaugaagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagaugcucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaccggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccgacggcguccucgaguccgagauggucauccccaagaacuucgccggccccgucucccagcacaacaaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgcccucgucuccgucuccccccucuuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucuggugcgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggcaacaucgucacccagcagcccgaguccaacauccucgacaucgaccuccgccccgccuccgccuggacccucuacgccgucgccaccaccuucaucacccccaugcuccgccacuccaucgagaacuccuccgucaacaugucccucaccgccaucgccaaccaggccaccguccucaugggccucggcaagggcuggccccucuccaagauggacaucggcgucccccuccucgccaucggcugcugcucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaucaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucugcaucaugaacaacaccacccgccuccgccgcggcaccggccaccuccgcaagacccucggcgacaagugcaagucccgccucaacacccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccaggacuggcucgcccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12331 - RNA, 9876 nt, Artificial Sequence
  derived and/or modified CDS sequence (opt2) from DENV-2__KU517845__SS-prME
accgccggcaucaucaucaugaugauccccaccgucaucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccgccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucauggccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccauccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucguccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccgucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccaaccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagaucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccucccacaugaagggcgagcaccgcaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12332 - RNA, 9876 nt, Artificial Sequence
  derived and/or modified CDS sequence (opt2) from DENV-2__KU517847__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagguccucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgagaacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccgcccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccuccuuccucaagaacgacauccccaugaccggcccccucgucgccggcggccuccucaccgucugcuacguccucaccggccgcuccgccgaccucgagcucgagcgcgccgccgacauccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgccuccauccccaucaccgccgccgccugguaccucugggaggucaagaagcagcgcgccggcguccucugggacguccccucccccccccccgucggccgcgccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgccgcuacggcggcgcccucguccgcaacccccccucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgccaccgaggagaucgccgucaagaacuggcucguccgcgucggccgcgagcgccucucccgcauggccaucuccggcgacgacugcgucgucaagcccuucgacgaccgcuucgccaacgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12333 - RNA, 9876 nt, Artificial Sequence
  derived and/or modified CDS sequence (opt2) from DENV-2__JQ955623__SS-prME
accgccggcaugaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcucgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacgacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucaacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggagaccgccguccacgacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 12334 - RNA, 9876 nt, Artificial Sequence
  derived and/or modified CDS sequence (opt2) from DENV-2__KR779782__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgagcagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12335 - RNA, 9876 nt, Artificial Sequence
  derived and/or modified CDS sequence (opt2) from DENV-2__KM279608__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgucaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuaccuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacaaccccgucaacaucgaggccgagccccccuucggcgacuccuacaucaucaucggcgucgagcccggccagcucaagcucuccugguacaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggcgcaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccucgagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucaagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12336 - RNA, 9876 nt, Artificial Sequence
  derived and/or modified CDS sequence (opt2) from DENV-2__KM279605__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacaaccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccucgagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12337 - RNA, 9876 nt, Artificial Sequence
  derived and/or modified CDS sequence (opt2) from DENV-2__KM279609__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12338 - RNA, 9876 nt, Artificial Sequence
  derived and/or modified CDS sequence (opt2) from DENV-2__KM279607__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuaccuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacaaccccgucaacaucgaggccgagccccccuucggcgacuccuacaucaucaucggcgucgagcccggccagcucaagcucuccugguacaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccucgagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12339 - RNA, 9876 nt, Artificial Sequence
  derived and/or modified CDS sequence (opt2) from DENV-2__KM279606__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacaaccccgucaacaucgaggccgagccccccuucggcgacuccuacaucaucaucggcgucgagcccggccagcucaagcucuccugguacaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccucgagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgccgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12340 - RNA, 9876 nt, Artificial Sequence
  derived and/or modified CDS sequence (opt2) from DENV-2__JN851113__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12341 - RNA, 9876 nt, Artificial Sequence
  derived and/or modified CDS sequence (opt2) from DENV-2__GU370050__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccauccuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacaagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12342 - RNA, 9876 nt, Artificial Sequence
  derived and/or modified CDS sequence (opt2) from DENV-2__JN851129__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucuccgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaaccucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacaucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccucgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12343 - RNA, 9876 nt, Artificial Sequence
  derived and/or modified CDS sequence (opt2) from DENV-2__JN851128__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaccaccccgccacccuccgcaaguacugcaucgaggccaagcucaccaacaccaccaccgccucccgcugccccacccagggcgagcccucccucuccgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaaccucuggcucaagcucaaggagcgccaggacgucuucugcgacuccaagcucauguccgccgccaucaaggacaaccgcgccguccacgccgacaugggcuacuggaucgaguccgccaucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacaucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccucgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12344 - RNA, 9876 nt, Artificial Sequence
  derived and/or modified CDS sequence (opt2) from DENV-2__JN851130__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugauggcccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12345 - RNA, 9876 nt, Artificial Sequence
  derived and/or modified CDS sequence (opt2) from DENV-2__JN851125__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccucaagcagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagaugaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaaggucguccgcaacauggagaaguaccagcucgccgucaccaucauggccauccucugcguccccaacgccgucauccuccagaacgccuggaaggucuccugcaccacccucgccgucgucuccgucuucccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgaguccgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccuccaccacccagcagcacgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccucucccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12346 - RNA, 9876 nt, Artificial Sequence
  derived and/or modified CDS sequence (opt2) from DENV-2__JN851123__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccucaagcagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgagaucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucaucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccaucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12347 - RNA, 9876 nt, Artificial Sequence
  derived and/or modified CDS sequence (opt2) from DENV-2__JN851118__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12348 - RNA, 9876 nt, Artificial Sequence
  derived and/or modified CDS sequence (opt2) from DENV-2__JN851124__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccucaagcagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccugggucaugcgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagaugaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaaggucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgaguccgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccuccaccacccagcagcacgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccucucccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggucaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12349 - RNA, 9876 nt, Artificial Sequence
  derived and/or modified CDS sequence (opt2) from DENV-2__JN851114__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12350 - RNA, 9876 nt, Artificial Sequence
  derived and/or modified CDS sequence (opt2) from DENV-2__JN851126__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccucaagcagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgagaucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacaccauccuccucgucgccgucuccuucgucacccucaucaccggcaacauguccuuccgcgaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccgcccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcgucaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaagcacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12351 - RNA, 9876 nt, Artificial Sequence
  derived and/or modified CDS sequence (opt2) from DENV-2__JN851121__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccaaccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12352 - RNA, 9876 nt, Artificial Sequence
  derived and/or modified CDS sequence (opt2) from DENV-2__JN851115__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccaguggcuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccaguccgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuacgaggaguacaccgacuacaugcccuccaugaagcgcuuccgccgcgaggaggaggaggccggcguccucugguga

SEQ ID NO: 12353 - RNA, 9876 nt, Artificial Sequence
  derived and/or modified CDS sequence (opt2) from DENV-2__JN851127__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccucaagcagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucuccgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgagaucaagcucaccaucaugaccggcgacaucaagggcaucaugcaggccggcaagcgcucccuccgcccccagcccaucgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgucaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccgccagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucaucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagcgcaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcguccacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccaucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12354 - RNA, 9876 nt, Artificial Sequence
  derived and/or modified CDS sequence (opt2) from DENV-2__JN851120__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccgucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaucgaggaggaggaggccggcguccucugguga

SEQ ID NO: 12355 - RNA, 9876 nt, Artificial Sequence
  derived and/or modified CDS sequence (opt2) from DENV-2__JN851131__SS-prME
accgccggcgucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccaucgaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggaggucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgccccuccaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgucgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgaguggaucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccauccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagaagcccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucaacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12356 - RNA, 9876 nt, Artificial Sequence
  derived and/or modified CDS sequence (opt2) from DENV-2__JN851122__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucacccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaucggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12357 - RNA, 9876 nt, Artificial Sequence
  derived and/or modified CDS sequence (opt2) from DENV-2__JN851116__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12358 - RNA, 9876 nt, Artificial Sequence
  derived and/or modified CDS sequence (opt2) from DENV-2__GU370051__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccucgagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgacaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgacaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucacccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucggcaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucgagaacuggcucaugcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12359 - RNA, 9876 nt, Artificial Sequence
  derived and/or modified CDS sequence (opt2) from DENV-2__EU359009__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccuccccuuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacaccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12360 - RNA, 9876 nt, Artificial Sequence
  derived and/or modified CDS sequence (opt2) from DENV-2__KC131142__SS-prME
accgccggcaucaucaucauggucauccccaccgucauggccuuccaccucaccacccgcaacggcgagccccacaugaucgucucccgccaggagaagggcaagucccuccucuucaagaccgagaacggccucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccucgagaucgaggacgacaucuuccgcaagaagcgccucaccgucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacaccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucgucaagcuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcggcgccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcguccacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12361 - RNA, 9876 nt, Artificial Sequence
  derived and/or modified CDS sequence (opt2) from DENV-2__AY858035__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucgucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacacccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagacccgccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12362 - RNA, 9873 nt, Artificial Sequence
  derived and/or modified CDS sequence (opt2) from DENV-2__JX567951__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugg

SEQ ID NO: 12363 - RNA, 9873 nt, Artificial Sequence
  derived and/or modified CDS sequence (opt2) from DENV-2__JX567950__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccgucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucuccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucaacgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaguaccucggccucggcuccaucaccacccaggaguccgaguccaacauccucgacaucgaccuccgccccgccuccgccuggacccucuacgccgucgccaccaccuucgucacccccaugcuccgccacuccaucgucaacuccuccgucaacgucacccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaagaacgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgccgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugg

SEQ ID NO: 12364 - RNA, 9873 nt, Artificial Sequence
  derived and/or modified CDS sequence (opt2) from DENV-2__HQ012538__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugg

SEQ ID NO: 12365 - RNA, 9873 nt, Artificial Sequence
  derived and/or modified CDS sequence (opt2) from DENV-2__HQ012533__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugg

SEQ ID NO: 12366 - RNA, 9873 nt, Artificial Sequence
  derived and/or modified CDS sequence (opt2) from DENV-2__HQ012534__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucaugcucggcguccccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugg

SEQ ID NO: 12367 - RNA, 9873 nt, Artificial Sequence
  derived and/or modified CDS sequence (opt2) from DENV-2__HQ012535__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgccgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugg

SEQ ID NO: 12368 - RNA, 9873 nt, Artificial Sequence
  derived and/or modified CDS sequence (opt2) from DENV-2__HQ012536__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgccucgacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacggcaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucauggucauggucggcgucgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggaugggcgacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugg

SEQ ID NO: 12369 - RNA, 9873 nt, Artificial Sequence
  derived and/or modified CDS sequence (opt2) from DENV-2__HQ012537__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccuccgcaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaagcacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgccgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugg

SEQ ID NO: 12370 - RNA, 9876 nt, Artificial Sequence
  derived and/or modified CDS sequence (opt2) from DENV-2__KU365901__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccaggagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugcaacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgaguucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucaccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggcgcgucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggccgcaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12371 - RNA, 9876 nt, Artificial Sequence
  derived and/or modified CDS sequence (opt2) from DENV-2__GQ398258__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgaccccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuacaagggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucgucaagaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccaccagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggguccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12372 - RNA, 9876 nt, Artificial Sequence
  derived and/or modified CDS sequence (opt2) from DENV-2__GQ398259__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuacaagggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucgucaagaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccaccagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggguccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12373 - RNA, 9876 nt, Artificial Sequence
  derived and/or modified CDS sequence (opt2) from DENV-2__GQ398268__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12374 - RNA, 9876 nt, Artificial Sequence
  derived and/or modified CDS sequence (opt2) from DENV-2__GQ398263__SS-prME
accgccggcaugaucaucaugaugauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaccaccaaccgcgccuggaacucccucgaggucgaggacuacggcuucggcgucuucaccaccaacaucuggcucaagcucaaggagcgccaggacguccucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggacaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacgucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuacaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12375 - RNA, 9876 nt, Artificial Sequence
  derived and/or modified CDS sequence (opt2) from DENV-2__GQ398264__SS-prME
accgccggcaugaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaugaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcagcucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaccgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12376 - RNA, 9876 nt, Artificial Sequence
  derived and/or modified CDS sequence (opt2) from DENV-2__GQ398260__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaucggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucaacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaucggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12377 - RNA, 9876 nt, Artificial Sequence
  derived and/or modified CDS sequence (opt2) from DENV-2__GQ398262__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgagguccgccucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucaacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12378 - RNA, 9876 nt, Artificial Sequence
  derived and/or modified CDS sequence (opt2) from DENV-2__GQ398261__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccuggaucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucaacuucugcgagggcaccaccgucgucgucaccggcgacugcggcaaccgcggccccgcccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaucggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12379 - RNA, 9876 nt, Artificial Sequence
  derived and/or modified CDS sequence (opt2) from DENV-2__GQ398313__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12380 - RNA, 9876 nt, Artificial Sequence
  derived and/or modified CDS sequence (opt2) from DENV-2__GQ398285__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaugggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcaccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcggcaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucgucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12381 - RNA, 9876 nt, Artificial Sequence
  derived and/or modified CDS sequence (opt2) from DENV-2__GQ398298__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggccuccucggcauggcccucuuccucgaggagaugcuccgcacccgcgucggcaccaagcacgccaugcuccucgucgucgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacaucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12382 - RNA, 9876 nt, Artificial Sequence
  derived and/or modified CDS sequence (opt2) from DENV-2__GQ398301__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgccuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12383 - RNA, 9876 nt, Artificial Sequence
  derived and/or modified CDS sequence (opt2) from DENV-2__GQ398312__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaucgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12384 - RNA, 9876 nt, Artificial Sequence
  derived and/or modified CDS sequence (opt2) from DENV-2__GQ398289__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucaucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccucccucuucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgccgcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12385 - RNA, 9876 nt, Artificial Sequence
  derived and/or modified CDS sequence (opt2) from DENV-2__GQ398290__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaacuucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgagaacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacacccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12386 - RNA, 9876 nt, Artificial Sequence
  derived and/or modified CDS sequence (opt2) from DENV-2__GQ398284__SS-prME
accgccggcgucaucaucaugcucauccccaccgccauggccuuccaccucaccacccgcaacggcgagccccacaugaucgucggcaagcaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuuccucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucgcccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuaccgcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaaccacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12387 - RNA, 9876 nt, Artificial Sequence
  derived and/or modified CDS sequence (opt2) from DENV-2__GQ398308__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacgacacccaguucugcaucaagguccucaaccccuacaugcccuccgucaucgagaagauggagacccuccagcgcaaguacggcggcgccaucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12388 - RNA, 9876 nt, Artificial Sequence
  derived and/or modified CDS sequence (opt2) from DENV-2__GQ398287__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucaucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccucccucuucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacaccguccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgccgcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12389 - RNA, 9876 nt, Artificial Sequence
  derived and/or modified CDS sequence (opt2) from DENV-2__GQ398302__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12390 - RNA, 9876 nt, Artificial Sequence
  derived and/or modified CDS sequence (opt2) from DENV-2__GQ398272__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaucacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggccgcggcuggccccucuccaagauggacaucggcgucccccuccucgccaucggcugcuacucccaggucaaccccaucacccucaucgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 12391 - RNA, 9876 nt, Artificial Sequence
  derived and/or modified CDS sequence (opt2) from DENV-2__GQ398292__SS-prME
accgccggcgucuucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggaucaugcgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaaguccaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccaugcuccucgucgccgucuccuucgucacccucaucaccggcaacauguccuuccgcgaccucggccgcgucauggucauggucggcgccaccaugaccgacgacaucggcaugggcaucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucaucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12392 - RNA, 9876 nt, Artificial Sequence
  derived and/or modified CDS sequence (opt2) from DENV-2__GQ398267__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaucgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaucggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaucgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12393 - RNA, 9876 nt, Artificial Sequence
  derived and/or modified CDS sequence (opt2) from DENV-2__GQ398266__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaucgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12394 - RNA, 9876 nt, Artificial Sequence
  derived and/or modified CDS sequence (opt2) from DENV-2__GQ398265__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12395 - RNA, 9876 nt, Artificial Sequence
  derived and/or modified CDS sequence (opt2) from DENV-2__KX702403__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucauccucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcgagaagcgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccaucccccacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaccgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 12396 - RNA, 9876 nt, Artificial Sequence
  derived and/or modified CDS sequence (opt2) from DENV-2__KX702404__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgagaucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucgucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccaacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 12397 - RNA, 9873 nt, Artificial Sequence
  derived and/or modified CDS sequence (opt2) from DENV-2__JQ686088__SS-prME
accaccggcaugaucaucaugcucauccccaccgucauggccuuccaccucaccacccgcaacggcgagccccacaugaucgucucccgccaggacaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucgccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaagaucguccagcccgagaaccucgaguacaccaucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggaccgccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcaacggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggucggcaagcgcucccuccagccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaaccucgccggccccgucucccagcacaacaaccgccccggcuacuacacccagaccgccggccccuggcaccucggcaagcucgagauggacuucgacuucugcaagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucaucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugauccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggauccccaucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucgucuccggccucuuccccgucuccguccccaucaccgccgccgccugguaccucugggaggucaagaagcagcgcgccggcguccucugggacguccccucccccccccccgccggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccguccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacaucaagacccgcaccaacgacugggacuucgucgucaccaccgacaucuccgagaugggcgccaacuucaaggcccagcgcgucaucgacccccgccgcugcaugaagcccgucauccucaccgacggcgaggagcgcgucauccucgccggccccaugcccgucacccacuccuccgccgcccagcgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacgccgacccccucgcccucaaggaguucaaggaguucgccgccggccgcaagucccucacccucaaccucaucaccgagaugggccgccuccccaccuucaugacccagaagguccgcgacgcccucgacaaccucgccguccuccacaccgccgaggccggcggcaaggccuacaaccacgcccucaacgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgucacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccgcccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagcgcugcgacacccuccucugcgacaucggcgaguccucccccucccccaccgucgaggccggccgcacccuccgcguccucaaccucgucgagaacuggcucuccaacaacacccaguucugcgucaagguccucaaccccuacaugcccuccgucaucgagaagauggaggcccuccagcgcaagcacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucggcgacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccgccgaggagaucgccguccagaacuggcucguccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12398 - RNA, 9876 nt, Artificial Sequence
  derived and/or modified CDS sequence (opt2) from DENV-2__KF479233__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccagaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuacaagggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgagcucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagaagaagaagcucaagccccgcuggcucgacgcccgcaucuacuccgacccccucgcccucaaggaguucaaggaguucgccgccggccgcaagucccucaccaugaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgucacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaaguccauccagcaccucaccaccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 12399 - RNA, 9876 nt, Artificial Sequence
  derived and/or modified CDS sequence (opt2) from DENV-2__KX372564__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagguccucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccgcccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccuccuuccucaagaacgacauccccaugaccggcccccucgucgccggcggccuccucaccgucugcuacguccucaccggccgcuccgccgaccucgagcucgagcgcgccgccgacauccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggccgcgccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgccgcuacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgccaccgaggagaucgccgucaagaacuggcucguccgcgucggccgcgagcgccucucccgcauggccaucuccggcgacgacugcgucgucaagcccuucgacgaccgcuucgccaacgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12400 - RNA, 9873 nt, Artificial Sequence
  derived and/or modified CDS sequence (opt2) from DENV-2__KX274130__SS-prME
uccgccgccacccuccuccuccucguccccaccaucauggccuuccaccucaccacccgcaacggcgagccccacaugaucgucgcccgccacgagaagggcaagucccucaucuucaagaccgagaacggcgucaacaugugcacccucauggccauggaccucggcgagcucugcgaggagaccgucaccuacaagugccccuaccucaagcaguccgagcccgaggacaucgacugcuggugcaacaccaccuccaccugggucaccuacggcaccugcuccuccuccggcgagcaccgccgcgagaagcgcuccgucgcccucgccccccacgucggcaugggccucgagacccgcaccgagaccuggauguccuccgagggcgccuggaagcacgcccagcgcaucgagaacuggauccuccgccaccccggcuacaccgucauggccgccgccaucgccauggccaucggcaccaacaacuuccagcgcgcccucaucuucguccuccucaccgccgucgcccccuccaugaccaugcgcugcgucggcaucgccaaccgcgacuucgucgagggcgucuccggcggcuccugggucgacaucguccucgagcacggcuccugcgucaccaccauggccaagaacaagcccacccucgacuucgagcucaccaagaccgaggccaagcuccccgccacccuccgcaaguacugcaucgaggccaagcucaccaacaccaccaccgagucccgcugccccacccagggcgagcccucccuccccgaggagcaggacaagcgcuucaucugccgccacucccucgucgaccgcggcuggggcaacggcugcggccucuucggcaagggcggcaucgucaccugcgccauguucaccugcaagaaguacauggagggcaagaucguccagcccgagaaccucgaguacaccgucgccgucaccccccacuccggcgaggagcacuccgucggcaacgacaccggcaagcacggccaggacgucaagaucaccccccaguccuccaucaccgagaccgcccucgagggcuacggcuccaucuccauggagugcuccccccgcaccggccucgacuucaacgagaugguccuccuccagauggaggacaaggccuggcucguccaccgccagugguuccucgaccucccccuccccuggcuccccggcuccgacacccagggcuccaacuggguccagaaggagacccucgucaccuucaagaacccccacgccaagaagcaggacgucgucguccucggcucccaggagggcgccaugcacuccgcccucaccggcgccaccgagauccagaugaccuccggcaaccuccucuucaccggccaccucaagugccgccuccgcauggacaagcucgagcucaagggcauguccuacuccaugugcaccggcaaguucaaggucgucaaggagaucgccgagacccagcacggcaccaucgucauccgcguccaguacgagggcgagggcucccccugcaagauccccuucgagaucauggaccucgagaagaagcacguccucggccgccucaucaccgucaaccccaucaucaccgagaaggacaagcccaccaacaucgaggccgagccccccuucggcgacuccuacauccucaucggcgucgagcccggccagcucaagaugaacugguucaagaagggcuccuccaucggccagauguucgagaccaccaugcgcggcgccaagcgcauggccauccucggcgacaccgccugggacuucggcucccucggcggcgucuucaacuccaucggcaaggcccuccaccaggucuucggcgccgucuacaacgccgccuucuccggcgucuccuggaccaugaagauccucaucggcgucaucaucaccuggaucggcaugaacucccgcuccaccuccauguccaucacccucgucauggucggccucgucacccucuaccucggcgucgucguccaggccgacuccggcugcgucgucuccuggaagaccaaggagcucaagugcggcuccggcaucuucgucaccgacaacguccacgucuggaccgagcaguacaaguuccagcccgagucccccgccaagcucgccgccgccaucaagaaggcccacgaggagggcgucugcggcauccgcuccgucacccgccucgagaacaucauguggaagcagaucacccccgagcucaaccacauccucaccgagaacgacgucaaggucaccaucaugaccggcgacaucaagggcauccuccagcagggccgccgcgcccuccgcccccagcccaccgagcucaaguacuccuggaaguccuggggcaaguccaagaucgucuccuccgagacccacaaccagaccuuccucaucgacggccccgagaccaccgagugccccgacaccaaccgcgccuggaacucccucgaggucgaggacuacggcuucggccucuucuccaccaacaucuggcuccgccuccgcgagaagcaggacacccucugcgacuccaagcucauguccgccgccgucaaggacgagcgcgccauccacgccgacaugggcuacuggaucgaguccaagcucaacggcuccuggaagaucgagaaggccuccuuccucgaggucaaguccugcaccuggccccgcucccacacccucugguccaacggcguccucgaguccgagaugaucauccccaagaaccucggcggccccgucucccagcacaacuaccgccccggcuacuacacccagaccaccggccccuggcaccucggcaagcucgagauggacuucgacuacugcgagggcaccaccgucaucgucaccgaggagugcaacaaccgcggccccucccuccgcaccaccaccgccuccggcaagcucaucaccgaguggugcugccgcuccugcaccaugcccccccuccgcuucaagggcgaggacggcugcugguacggcauggagauccgcccccucaaggagaaggaggagaaccucgucaacucccucgucaccgccggccacggccagaucgacaacuucucccucggcauccucggcaucgcccucuuccucgaggaggucaugaagucccgcaucggcaucaagcacaccaucggcaugaccaucaucaccuuccuccuccucgucaccggcaacgucuccuaccgcgaccucggccgcgucauccucauggucggcuccaccauggccgacgagaugggcaugggcgucaccuaccucgcccuccucgccaccuuccgcauccgccccaccuucgcccucgcccucaugauccgcaagcucaccuccaaggagcuccucauggccaccaucggcaucguccucaucgcccagugcgacguccccggcaccauccucgagaucaccgacgccugcgcccucggccucaugcuccucaagaugacccgcgagcucgagcgcuaccagcucgccgucacccuccucucccucaccugcauccccaacgccaccaucauguggggcgccuggaaggucaccugcaccauccucacccucgucuccauggccccccucuuccucaccaccucccgccagaagaccgacuggguccccgucgcccucuccaucuacggccucaaccccaccgccaucuacuucaccacccucgccaaggccaagaagauccgcuccuggccccucaacgaggccgucauggccgucggcauggucuccauccucgccuccucccuccuccgcaacgacauccccauggccggcccccucgucgccggcggccuccucacccucugcuacguccucaccggccgcuccgccgaccucgagcucgagaaguccgccgacaucaaguggaacgacgacgccgagaucuccggcuccucccccaucaucaacgucgccgucuccgaggacggcuccauguccaucaaggacgaggaggaggagaacacccucaccauccucauccgcaccggccuccucgccaucuccggcauguaccccauggccauccccgccaccgccgccgucugguacuucugggaggcccgcaagcagcgcgccggcguccucugggacguccccucccccccccccaccggcaaggccgagcucgaggagggcgccuaccgcaucaagcagcgcggcaucuucggcuacucccagaucggcgccggcgucuacaaggagggcaccuuccacaccauguggcacgucacccgcggcuccguccucaugugcaagggcaagcgccucgagcccuccugggccgacgucaagaaggaccucaucuccuacggcggcggcuggcgccucgacggcgaguggaccgagggcgaggagguccagguccucgcccucgagcccggcaagaacccccgcgccguccagaccaagcccggcauguucaagaccgacaccggccgcaucggcgccgucucccucgacuucgcccccggcaccuccggcucccccaucaucgacaagaagggcaaggucaucggccucuacggcaacggcgucgucaugaaguccggcgccuacgucuccuccaucgcccagaccgagaagcgcgaggacgagauccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucgccacccgcgucgagaugggcgaggccgccggcaucuucaugaccgccaccccccccggcuccaaggaccccuucccccaguccaacgcccccaucauggacgaggagcgcgagauccccgagcgcuccuggaacuccggccacgaguggaucaccgacuucgagggcaagaccgucugguucguccccuccauccgcgccggcaacgacaucgccaccugccuccgcaagaacggcaagaaggucauccagcucucccgcaagaccuucgacaccgaguacaucaagacccgcaacaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccccuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccgccauguucggccccgagcgcgagaagaccgacgccaucgacggcgaguaccgccuccgcggcgagucccgcaagaccuucgucgagcucaugcgccgcggcgaccuccccgucuggcucgccuacaaggucgccuccgagggcuacuccuacgccgaccgccgcuggugcuucgagggcgucaagaacaaccagauccucgaggagaaccucgaggucgagaucuggaccaaggagggcgagcgcaagaagcuccgccccaaguggcucgacgcccgcaccuacuccgacccccaggcccucaaggacuucaaggaguucgccgccggccgcaaguccaccacccucaaccucaucgccgagcucggccgccuccccaccuacaugacccagaagacccgcgacgcccucgacaaccucgccguccuccacaccgccgaggagggcggccgcgccuaccagcacgccaucuccgagcuccccgagacccucgagacccuccuccuccucugccuccucgccaccgucuccggcggcgucuuccucuuccucauguccggcaagggcaucggcaagauguccaugggccucggcugcaucaucaccgccuccggccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucacccucgucgccgccaccauggccaacgagaugggcuaccucgagaagaccaagaaggaccucggcuucggcaaccccuacgucgccucccacgaggccgccauccucgacaucgaccuccaccccgccuccgccuggacccucuacgccgucgccaccacccucaucacccccaugcuccgccacuccaucgagaacuccuccaccaacgucucccucaccgccaucgccaaccaggccaccguccucaugggccucggcaagggcuggccccucucccgcauggaccucggcgucccccuccucgcccucggcugcuacucccaggucaacccccucacccucaccgccucccuccuccuccucaucggccacuacgccaucaucggccccggccuccaggccaaggccacccgcgaggcccagaagcgcaccgccgccggcaucaugaagaaccccaccgucgacggcaucaccgucaucgacaucgagcccauccccuacgaccccaaguucgagaagcagcucggccaggucaugcuccucguccucugcgucgcccagguccucaugaugcgcaccaccugggccaugugcgaggcccucaccaucgccaccggccccaucuccacccucugggagggcaaccccggcaaguucuggaacaccaccaucgccgucuccauggccaacaucuuccgcggcuccuaccucgccggcgccggccuccucuucuccaucaugaagaacaccgucaccggccgccgcggcaccggcgucgccggcgagacccucggcgagaaguggaagaucaagcucaacggccucggccgcaccgacuuccagaccuacaagcgcuccggcaucaucgaggucgaccgcacccucgccaaggagggcaucaagcgcggcgagaccaaccaccacgccgucucccgcggcuccgccaagcuccgcugguucgucgagcgcaaccucgucaagcccgagggcaaggucaucgaccucggcugcggccgcggcggcugguccuacuacugcggcggccucaagaacgucaccgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaacauggucgagaacuggcucggcaacaaccaguucugcaucaagguccucaaccccuacaugcccuccgucaucgagaagauggagaaccuccagcgcaaguucggcggcacccucguccgcaacccccucucccgcaacuccacccacgagauguacugggucuccaacgccuccggcaacaucgucuccuccgucaacaugaucucccgcaugcucaucaaccgcuucaccaugaagcacaagaagcccaccuacgagcaggacgucgaccucggcuccggcacccgcaacgucggcaucgagaccgagaagcccaaccucgagaucaucggcaagcgcaucgagaagaucaaggacgagcacaagcagaccuggcacuacgaccucgaccaccccuacaagaccugggccuaccacggcuccuacgagaccaagcagaccggcuccgccuccuccaugaucaacggcgucgucaagcuccucaccaagcccugggacgucauccccauggucacccagauggccaugaccgacaccacccccuucggccagcagcgcgucuucaaggagaaggucgacacccgcacccccgagcccaaggagggcaccaagaagcucaugaagcucaccgccaaguggcucugggccgagcucggccgccacaaggucccccgcaugugcacccgcgacgaguucaccaacaagguccgcuccaacgccgccaugggcgccgucuucaccgaggagaaccgcugguccuccgccaaggaggccgucgaggacgaggccuucugggaccucgucgaccgcgagcgcaagcuccaccuccagggcaagugcgagaccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgagaucggcgccaaggacggcggcaugauguacgccgacgacaccgccggcugggacacccgcgucaccgaggaggaccucaagaacgaggagaugaucuccgagcagaugaagggcgagcaccgcacccucgccgaggccaucuucaagcucaccuaccagaacaaggucguccgcguccagcgccccacccccaagggcaccgucauggacaucaucucccgccgcgaccagcgcggcuccggccaggucggcaccuacggccucaacaccuucaccaacauggaggcccagcucauccgccagauggagggcgagggccucuuccgcgacaucuccaagcucaccauccaggaggagaccgccauccucaccuggcucaaggagaagggccgcgaccgccucucccgcauggccaucuccggcgacgacugcgucgucaagcccgucgacgaccgcuucgcccacgcccucaccgcccucaacgacaugggcaagguccgcaaggacauccagcagugggaggccuccaagggcuggaacgacuggacccagguccccuucugcucccaccacuuccacgagaucaucaugaaggacggccgcaagcucgucguccccugccgcaaccaggacgagcucaucggccgcgcccgcaucucccagggcgccggcugggcccucaaggagaccgccugccucggcaaggccuacgcccagauguggucccucauguacuuccaccgccgcgaccuccgccucgccgccaacgccaucugcuccgccguccccucccacuggguccccaccucccgcaccaccugguccauccacgcccaccaccaguggaugaccaccgaggacaugcucgacgucuggaaccgcgucuggauccucgagaaccccuggauggacgacaagaccugcgucaaguccugggaggagguccccuaccucggcaagcgcgaggaccaguggugcggcucccucaucggccucaccucccgcgccaccugggccaagaacaucaaggucgccaucgagcagguccgcucccucaucggcaaggaggaguacaccgacuacaugcccuccaugaagcgcuucaagcaggagcaguccaccgagggcgcccucugguga

SEQ ID NO: 12401 - RNA, 9876 nt, Artificial Sequence
  derived and/or modified CDS sequence (opt2) from DENV-2__GU289914__SS-prME
uccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgaccccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12402 - RNA, 9876 nt, Artificial Sequence
  derived and/or modified CDS sequence (opt2) from DENV-2__AY858036__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucgcccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgagaccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccgaguucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12403 - RNA, 9876 nt, Artificial Sequence
  derived and/or modified CDS sequence (opt2) from DENV-2__HQ332184__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccggcugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccacccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12404 - RNA, 9876 nt, Artificial Sequence
  derived and/or modified CDS sequence (opt2) from DENV-2__HQ332185__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaucaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaagaacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12405 - RNA, 9876 nt, Artificial Sequence
  derived and/or modified CDS sequence (opt2) from DENV-2__HQ332186__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacaccuucugguccaacggcguccucgaguccgagaugaucauccccaagaacuucgccggccccgucucccagcacaacuaccgccccggcuaccacacccagaucgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccacaccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12406 - RNA, 9876 nt, Artificial Sequence
  derived and/or modified CDS sequence (opt2) from DENV-2__HQ332187__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcauccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugauccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgucaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucggcgagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12407 - RNA, 9876 nt, Artificial Sequence
  derived and/or modified CDS sequence (opt2) from DENV-2__HQ332188__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcgucaugcaggccggcaagcgcucccuccgcccccagcccaccgagcucaaguacuccuggaagaccuggggcaaggccaagaugcucuccaccgagucccacaaccagaccuuccucaucgacggccccgagaccaccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaucgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgccaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagauccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12408 - RNA, 9876 nt, Artificial Sequence
  derived and/or modified CDS sequence (opt2) from DENV-2__HQ332189__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaacuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccucccccaccaucgaggccggccgcacccuccgcguccucaaccucgucgaggacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccacaccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12409 - RNA, 9876 nt, Artificial Sequence
  derived and/or modified CDS sequence (opt2) from DENV-2__JN368476__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaguccaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcaccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12410 - RNA, 9876 nt, Artificial Sequence
  derived and/or modified CDS sequence (opt2) from DENV-2__JF260983__SS-prME
accgccggcuuccucaucauggucauccccaccgucauggccuuccaccucaccacccgcaacggcgagccccacaugaucgucuccaagaacgagaagggcaagggccuccucuucaagaccgagaacggcaucaacaugugcacccucauggccauggaccucggcgagcucugcgaggacaccgucaccuacaagugccccuuccucaagcagaacgagcccgaggacaucgacugcuggugcaacuccaccuccaccugggucaccuacggcaccugcuccuccaccggcgagcaccgccgcgagaagcgcuccgucgcccucgucccccacgucggcaugggccucgagacccgcaccgagaccuggauguccuccgagggcgccuggaagcaggcccagcgcaucgagaccuggauccuccgccaccccggcuucacccucauggccgccguccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguucugcaucgaggccaagcucaccaacaccaccaccgagucccgcugccccacccagggcgagcccucccucgucgaggagcaggacaagcgcuucgucugccgccacuccauggucgaccgcggcuggggcaacggcugcggccucuucggcaagggcggcaucgucaccugcgccauguucaccugccucaagaagauggagggcaaggucguccagcccgagaaccucgaguacaccaucgucaucaccccccacuccggcgaggagcacgccgucggcaacgacaccggcaagcacggcaaggaggucaagaucaccccccaguccuccaucuccgagaccgagcucaccgacuacggcaccaucaccauggagugcuccccccgcaccggccucgacuucaacgagaugguccuccuccagauggaguccaaggccuggcucguccaccgccagugguuccucgaccucccccuccccuggcuccccggcgccgacacccagggcuccaacuggauccagaaggagaugcucgucaccuucaagaacccccacgccaagcgccaggacgucgucguccucggcucccaggagggcgccaugcacaccgcccucaccggcgccaccgagauccagaugucccucggcaacauccucuucaugggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacgacucccccugcaagauccccuucgagaucauggaccucgagaagaagcacguccucggccgccucaucaccgucaaccccaucgucaccgagaaggacucccccaucaacaucgaggccgagccccccuucggcgacuccuacaucgucaucggcgucgagcccggccagcucaagcucaacugguucaagaagggcuccuccaucggccagauguucgagaccaccaugcgcggcgccaagcgcauggccauccucggcgacaccgccugggacuucggcuccaucggcggcgucuucaccuccgucggcaaggcccuccaccaggucuucggcgccaucuacggcgccgccuucuccggcgucuccuggaccaugaagauccucaucggcgucgucaucaccuggaucggcaugaacucccgcuccaccucccucuccgucacccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgacucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgagaucaagggcaucaugcaggccggccgccgcucccucaagccccagcccaccgagcuccgcuacuccuggaagaccuggggcaaggccaagguccucuccaccgagcuccagaaccagaccuuccucaucgacggccccgagaccaccgagugccccaacuccaaccgcgccuggaacucccucgaggucgaggacuacggcuucggcaucuucaccaccaacaucuggcucaagcuccgcgagaagcaggacaugaucugcgacuccaagcucauguccgccgccgucaaggacgaccgcgccguccacgccgacaugggcuacuggaucgagucccgccucaacgacaccuggaagauggagaaggccuccuucaucgaggucaaguccugcuacuggccccgcucccacacccucugguccaacggcguccucgaguccgagaugaucauccccaagaaccucgccggccccgucucccagcacaacuaccgccccggcuacuacacccagaccgccggccccuggcaccucggcaagcucgagauggacuucgaguucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagcgcgaggagaaccucgucaacucccucgucaccgccggccacggccagaucgacaacuucucccucggcauccucggcauggcccuccuccucgaggagaugcuccgcacccgcgucggcaccaagcacgcccuccuccucgucgccaucuccuucgucacccucaucaccggcaacauguccuucaaggaccucggccgcgucaucaucauggucggcgccgccaugaccgacgagaugggcaugggcgucaccuaccucgcccuccucgccgccuuccgcguccgccccaccuucgccgucggccuccuccuccgcaagcucaccuccaaggagcuccucauggccaccaucggcgucguccuccucucccaguccaacauccccggcaccguccucgagcucaccgacgccaucgcccucggcaucaugguccucaagaucaugcgcuccauggagaaguaccagcucgccgucaccgucauggccaugcucugcauccccaacgucaugauccuccagcacgccuggaaggucggcugcaccauccucgccgccgucuccgucuccccccuccuccucaccuccucccagcagaagaccgacuggaucccccucgcccucaccaucaagggccucaaccccaccgccaucuuccucaccacccucucccgccccuccaagauccgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgaggucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggagaccaagaagcagcgcgccggcguccucugggacguccccucccccccccccaugggcaaggccgagcucgaggacggcgccuaccgcaucaagcagcgcggcaucuucggcuacucccagaucggcgccggcgucuacaaggagggcaccuuccacaccauguggcacgucacccgcggcgccguccucguccacaagggcaagcgccucgagcccuccugggccgacgucaagaaggaccucaucuccuacggcggcggcuggaagcucgagggcgaguggaaggacggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgaccgcaagggcaaggucgucggccucuacggcaacggcgucgucacccgcuccggcaccuacgucuccuccaucgcccagaccgagaaguccgucgaggacaaccccgagaucgaggacgacaucuuccgcaagaagcgccucaccaucauggaccuccaccccggcgccggcaagaccaagcgcuaccuccccgccaucguccgcgaggccauccgccgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgaguggaucaccaacuucaagggcaagaccgucugguucguccccuccauccgcgccggcaacgacaucgccgccugccuccgcaagaacggcaagcgcgucauccagcucucccgcaagaccuucgacaccgaguacaccaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucguccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugaagcgcggcgaccuccccgucuggcucgccuacaaggucgccuccgagggcaucaacuacgccgaccgcaaguggugcuucgacggcauccgcaacaaccagauccucgaggagaacaucgaggucgaggucuggaccaaggagggcgagcgcaagaagcucaagccccgcuggcucgacgcccgcaccuacuccgacccccucgcccucaaggaguucaaggaguucgccgccggccgcaagucccucacccucucccucaucaccgagaugggccgccuccccaccuucaugacccagaagacccgcgacgcccucgacaaccucgccguccuccacuccgccgagaugggcggccgcgccuacaaccacgcccucuccgagcuccccgagacccucgagacccuccuccuccucggccuccucgccaccgucaccggcggcaucuuccucuuccucauguccggccgcggcgucggcaagaugacccucggcaugugcugcaucaucaccgccuccggccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucacccucgucgccgccaccauggccaacgagaugggcuuccucgagaagaccaagaaggaccucggccucggcggcuucaccaugcagcagcccgagaucaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggcaaguucuggaacaccaccaucgccgucuccauggccaacaucuuccgcggcuccuaccucgccggcgccggccuccucuucuccaucaugcgcaacaccaccuccgcccgccgcggcaccggcaccaucggcgagacccucggcgagaaguggaagucccgccucaacgcccucggccgcuccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucgcccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagcgcugcgacacccuccucugcgacaucggcgaguccucccccaaccccaccgucgaggccggccgcacccuccgcguccucaaccucgucgagaacuggcucggcuccaacacccaguucugcaucaagguccucaaccccuacaugcccuccgucaucgagcgcauggagacccuccagcgcaaguucggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgagugcgagacccccaacauggacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggggcgagcucggccgccgcaagaagccccgcaucugcacccgcgccgaguucugcaacaagguccgcuccaacgccgcccucggcgccgucuucaccgacgagaacaaguggaaguccgcccgcgaggccgucgaggacgagcgcuucugggagcucgucgagaaggagcgcaaccuccaccucgacggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacaucucccgcaaggccggcggcgccauguacgccgacgacaccgccggcugggacacccgcaucaccuccgaggaccucaagaacgaggagaugaucaccgaccagauggagggccgccacaagaagcucgccgaggccaucuuccgccucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggccucuucaaguccauccuccaccucaccccccaggaggagaccgccguccacgccuggcucguccgcgagggccgcgagcgccucgcccgcauggccaucuccggcgacgacugcgucgucaagccccucgacgaccgcuucgcccgcgcccucaccgcccucaacgacaugggcaagguccgcaaggacauccagcagugggagcccuccaagggcugguccgacuggacccagguccccuucugcucccaccacuuccacgagcucaucaugaaggacggccgcaagcucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucgccgucuggaaccgcgucuggauccaggacaaccccuggauggaggacaagacccccgucgaguccugggaggacauccccuaccucggcaagcgcgaggaccaguggugcggcucccucaucggccucaccucccgcgccaccugggccaagaacauccagaccgccaucaaccagguccgcgcccucaucggcgaggaggaguacauggacuacaugcccuccaugaagcgcuuccgcuccgaggaggaggaguccggcguccucugguga

SEQ ID NO: 12411 - RNA, 9876 nt, Artificial Sequence
  derived and/or modified CDS sequence (opt2) from DENV-2__AF119661__SS-prME
accgucggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaucaucauggccgccauccucgccuacaccaucggcaccacccacuuccagcgcgcccucaucuucauccuccucaccgccgucgcccccuccaugaccaugcgcugcaucggcgucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgucacccuccgcaaguacugcaucaaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccaccuucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugggucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagucccucgucgacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacaugucccuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucgcccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagaagggcauccucggcuacucccagaucggcaccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccaacaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaugguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuucaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggccguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12412 - RNA, 9876 nt, Artificial Sequence
  derived and/or modified CDS sequence (opt2) from DENV-2__EU056810__SS-prME
accgccggcaucaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgaggucgacuucaacuucugcgagggcaccaccgucgucgucaccggcgacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucaccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12413 - RNA, 9876 nt, Artificial Sequence
  derived and/or modified CDS sequence (opt2) from DENV-2__EU056811__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucaccuccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagauggucauccccaagaacaucgccggccccgucucccagcacaacaaccgccccggcuaccacacccagaccgccggccccuggcaccucggcaagcucgagauggacuucgacuucugcgagggcaccaccgucgucgucaccgaggagugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuuccucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucacccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggccgcgccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcggcggcgccuacgucuccgccaucgcccagaccgagaagggcaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggccacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccucaugcucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaugggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucgucccccccgagaagugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgccuccgaggagaucgccguccaggacuggcucguccgcgucggccgcgagcgccucucccgcauggccaucuccggcgacgacugcgucgucaagccccucgacgaccgcuucgccaaggcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12414 - RNA, 9876 nt, Artificial Sequence
  derived and/or modified CDS sequence (opt2) from DENV-2__DQ645545__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccucccagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12415 - RNA, 9876 nt, Artificial Sequence
  derived and/or modified CDS sequence (opt2) from DENV-2__DQ645546__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12416 - RNA, 9876 nt, Artificial Sequence
  derived and/or modified CDS sequence (opt2) from DENV-2__DQ645547__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaaguacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12417 - RNA, 9876 nt, Artificial Sequence
  derived and/or modified CDS sequence (opt2) from DENV-2__DQ645549__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggucaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12418 - RNA, 9876 nt, Artificial Sequence
  derived and/or modified CDS sequence (opt2) from DENV-2__DQ645550__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgccucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggucaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12419 - RNA, 9876 nt, Artificial Sequence
  derived and/or modified CDS sequence (opt2) from DENV-2__DQ645551__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacaccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12420 - RNA, 9876 nt, Artificial Sequence
  derived and/or modified CDS sequence (opt2) from DENV-2__DQ645552__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccucccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12421 - RNA, 9876 nt, Artificial Sequence
  derived and/or modified CDS sequence (opt2) from DENV-2__DQ645553__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccccggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucgccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12422 - RNA, 9876 nt, Artificial Sequence
  derived and/or modified CDS sequence (opt2) from DENV-2__DQ645554__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12423 - RNA, 9876 nt, Artificial Sequence
  derived and/or modified CDS sequence (opt2) from DENV-2__DQ645555__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccucccagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12424 - RNA, 9876 nt, Artificial Sequence
  derived and/or modified CDS sequence (opt2) from DENV-2__DQ645556__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaagaacauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacguccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12425 - RNA, 9876 nt, Artificial Sequence
  derived and/or modified CDS sequence (opt2) from DENV-2__AF204178__SS-prME
accgccggcaugaucaucaugcucauccccaccgucauggccuuccaccucaccacccgcaacggcgagccccacaugaucgucucccgccaggagaagggcaagucccuccucuucaagaccggcgacggcgucaacaugugcacccucauggccauggaccccggcgagcucugcgaggacaccaucaccuacaagugcccccuccucaagcagaacgagcccgaggacaucgacugguggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaugauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccucccucaacgaggagcaggacaagcgcuucgucugcaagcacuccauggucgaccgcggcuggggcaacggcugcggccucuucggcaagggcggcaucgucaccuucgccauguucaccugcaagaagaacaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccaugaagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacgacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgucaucaaggacaaccgcgccgcccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuucaucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgccaagaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagauccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucgucggcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccucuacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcguccgccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12426 - RNA, 9876 nt, Artificial Sequence
  derived and/or modified CDS sequence (opt2) from DENV-2__AF204177__SS-prME
accgccggcaugaucaucaugcucauccccaccgucauggccuuccaccucaccacccgcaacggcgagccccacaugaucgucucccgccaggagaagggcaagucccuccucuucaagaccggcgacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgaccucgagcucaucaagaccgaggccaagcaguccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacgagguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgagugcugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucuccaagaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacgccggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagcgcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagacccucuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaagcgcaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccagaacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagaccuccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12427 - RNA, 9876 nt, Artificial Sequence
  derived and/or modified CDS sequence (opt2) from DENV-2__DQ645540__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaccaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggucaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12428 - RNA, 9876 nt, Artificial Sequence
  derived and/or modified CDS sequence (opt2) from DENV-2__DQ645541__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaccaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12429 - RNA, 9876 nt, Artificial Sequence
  derived and/or modified CDS sequence (opt2) from DENV-2__DQ645542__SS-prME
accgccggcgucaucaucaugaugauccccaccgucgucgccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaccaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcggcaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggaucgaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12430 - RNA, 9876 nt, Artificial Sequence
  derived and/or modified CDS sequence (opt2) from DENV-2__AY702036__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccaugcccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaaccgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccucccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12431 - RNA, 9876 nt, Artificial Sequence
  derived and/or modified CDS sequence (opt2) from DENV-2__AY702034__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccaugcccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaaccgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccucccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12432 - RNA, 9876 nt, Artificial Sequence
  derived and/or modified CDS sequence (opt2) from DENV-2__AF208496__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugccccuuccuccgccagaacgagcccgaggacaucgacugcuggugcaacuucaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccaugcccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccucccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccacaagcgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12433 - RNA, 9876 nt, Artificial Sequence
  derived and/or modified CDS sequence (opt2) from DENV-2__AY702040__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucaccuccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgaccccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagauggucauccccaagaacuucgccggccccgucucccagcacaacaaccgccccggcuaccacacccagaccgccggccccuggcaccucggcaagcucgagauggacuucgacuucugcgagggcaccaccgucgucgucaccgaggagugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggccgcgccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcggcggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggacuucggccucggccacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccgcccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucgucccccccgagaagugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccuccgaggagaucgccguccaggacuggcucguccgcgucggccgcgagcgccucucccgcauggccaucuccggcgacgacugcgucgucaagccccucgacgaccgcuucgccaaggcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12434 - RNA, 9876 nt, Artificial Sequence
  derived and/or modified CDS sequence (opt2) from DENV-2__AY037116__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcggcugccacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucacccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucgucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgccugggcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgccuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacaucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 12435 - RNA, 9876 nt, Artificial Sequence
  derived and/or modified CDS sequence (opt2) from DENV-2__AF169678__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacaugaucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12436 - RNA, 9876 nt, Artificial Sequence
  derived and/or modified CDS sequence (opt2) from DENV-2__AF169679__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccaagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacaugaucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12437 - RNA, 9876 nt, Artificial Sequence
  derived and/or modified CDS sequence (opt2) from DENV-2__AF169680__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaucauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaacuuccucaucgacggccccgagaccgccgagugccccaacaccaaccgcgccuggaacucccucgaggucgaggacuacggcuucggcgucuucaccaccaacgucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggagcgccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagaugaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccuccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacaccgucucccgcggcuccgccaagcuccgcugguucgucgagcgcaacaugaucacccccgagggcaagguccucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12438 - RNA, 9876 nt, Artificial Sequence
  derived and/or modified CDS sequence (opt2) from DENV-2__AF169682__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccucccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgucuucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacugccucgcccgccucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12439 - RNA, 9876 nt, Artificial Sequence
  derived and/or modified CDS sequence (opt2) from DENV-2__AF169681__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccaagaccgccgagugccccaacaccaaccgcgccuggaacucccucgaggucgaggacuacggcuucggcgucuucaccaccaacaucuggcucaagcucaaggagaagcaggacgcccucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggagaaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgucuucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcuccgcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12440 - RNA, 9876 nt, Artificial Sequence
  derived and/or modified CDS sequence (opt2) from DENV-2__AF169683__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcacgccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuucuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgucuucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgagucccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggcaucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggccucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12441 - RNA, 9876 nt, Artificial Sequence
  derived and/or modified CDS sequence (opt2) from DENV-2__AF169684__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucucccgcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagaaguaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuucuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucuuccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgccgcuacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12442 - RNA, 9876 nt, Artificial Sequence
  derived and/or modified CDS sequence (opt2) from DENV-2__AF169685__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuucuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgucuucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgccgcuacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12443 - RNA, 9876 nt, Artificial Sequence
  derived and/or modified CDS sequence (opt2) from DENV-2__AF169686__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagaucuucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggcccgucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagaaguaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuucuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgucuucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgccgcuacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgagacccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12444 - RNA, 9876 nt, Artificial Sequence
  derived and/or modified CDS sequence (opt2) from DENV-2__AF169687__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcucaaguacuccuggaagaccuggggcaucgccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucaccgucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuucuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgucuucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcuccggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggcucccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12445 - RNA, 9876 nt, Artificial Sequence
  derived and/or modified CDS sequence (opt2) from DENV-2__AF169688__SS-prME
uccgccggcaugaucaucaugcucauccccaccgucauggccuuccaccucaccacccgcaacggcgagccccacaugaucgucuccauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagaccuccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugccgcauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcacgccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccucauccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuucuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgucuucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcaagacccucggcgagaaguggaagucccgccucaacgcccucggcaagaucgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 12446 - RNA, 9873 nt, Artificial Sequence
  derived and/or modified CDS sequence (opt2) from DENV-3__AB189125__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccuccugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacgucgacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgucaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcucccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12447 - RNA, 9873 nt, Artificial Sequence
  derived and/or modified CDS sequence (opt2) from DENV-3__AB189126__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaaggucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcauccucuucaucuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucccccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggagcucgagggcgccaucugguga

SEQ ID NO: 12448 - RNA, 9873 nt, Artificial Sequence
  derived and/or modified CDS sequence (opt2) from DENV-3__AB189127__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaaggucgucaccgccgagauccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccauccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcauccucuucauguucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccuccugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucccccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggagcucgagggcgccaucugguga

SEQ ID NO: 12449 - RNA, 9873 nt, Artificial Sequence
  derived and/or modified CDS sequence (opt2) from DENV-3__AB189128__SS-prME
accucccucugccucaugaugauccuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccguccucgcccucuuccucgcccacuucaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccaccgagcucaaguacuccuggaagaccuggggcaaggccaagaucgucaccgccgagacccagaacuccuccuucaucaucgacggccccaacacccccgagugccccuccgccucccgcgccuggaacgucugggaggucgaggaguacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccaacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggacggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaucuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucauccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaagaucacccaguggcucgaggccgagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccacaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12450 - RNA, 9873 nt, Artificial Sequence
  derived and/or modified CDS sequence (opt2) from DENV-3__AB214879__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccgucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaccucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaaguccggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgccuucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagcgcaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12451 - RNA, 9873 nt, Artificial Sequence
  derived and/or modified CDS sequence (opt2) from DENV-3__AB214880__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgccucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaaguccggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgccuucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagcgcaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12452 - RNA, 9873 nt, Artificial Sequence
  derived and/or modified CDS sequence (opt2) from DENV-3__AB214881__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgccucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaaguccggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgccuucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagcgcaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggagcucgagggcgccaucugguga

SEQ ID NO: 12453 - RNA, 9873 nt, Artificial Sequence
  derived and/or modified CDS sequence (opt2) from DENV-3__AB214882__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaccggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgccucccucaugugcuccaacaccaucuucacccucaccgucgccuggcgcaccgccacccucauccucgccggcaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaaguccggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgccuucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagcgcaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12454 - RNA, 9873 nt, Artificial Sequence
  derived and/or modified CDS sequence (opt2) from DENV-3__JX669489__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagaucgccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12455 - RNA, 9873 nt, Artificial Sequence
  derived and/or modified CDS sequence (opt2) from DENV-3__JX669498__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucggcaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12456 - RNA, 9873 nt, Artificial Sequence
  derived and/or modified CDS sequence (opt2) from DENV-3__KF954946__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccauccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcaucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgucggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccaugcucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggacggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucaccauggccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccuccucggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccauccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12457 - RNA, 9873 nt, Artificial Sequence
  derived and/or modified CDS sequence (opt2) from DENV-3__KF954947__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcaucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgucggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccaugcucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggacggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucaccauggccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcgcauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccauccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12458 - RNA, 9873 nt, Artificial Sequence
  derived and/or modified CDS sequence (opt2) from DENV-3__KF954945__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccauccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcaucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgucggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccaugcucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggacggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucaccauggccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccauccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12459 - RNA, 9873 nt, Artificial Sequence
  derived and/or modified CDS sequence (opt2) from DENV-3__JX669495__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12460 - RNA, 9873 nt, Artificial Sequence
  derived and/or modified CDS sequence (opt2) from DENV-3__JX669499__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcaucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12461 - RNA, 9873 nt, Artificial Sequence
  derived and/or modified CDS sequence (opt2) from DENV-3__JX669492__SS-prME
accuccuucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12462 - RNA, 9873 nt, Artificial Sequence
  derived and/or modified CDS sequence (opt2) from DENV-3__JX669500__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12463 - RNA, 9873 nt, Artificial Sequence
  derived and/or modified CDS sequence (opt2) from DENV-3__JX669497__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgccuccaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12464 - RNA, 9873 nt, Artificial Sequence
  derived and/or modified CDS sequence (opt2) from DENV-3__JX669501__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaccaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccauggaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucauguacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12465 - RNA, 9873 nt, Artificial Sequence
  derived and/or modified CDS sequence (opt2) from DENV-3__JX669494__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacaccgucucccgccuccuccucaaccgcuucaccaugacccaccgccgccccaccaccgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12466 - RNA, 9873 nt, Artificial Sequence
  derived and/or modified CDS sequence (opt2) from DENV-3__JX669503__SS-prME
accuccuucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucguccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12467 - RNA, 9873 nt, Artificial Sequence
  derived and/or modified CDS sequence (opt2) from DENV-3__JX669493__SS-prME
accuccuucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaucggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12468 - RNA, 9873 nt, Artificial Sequence
  derived and/or modified CDS sequence (opt2) from DENV-3__JX669504__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucacccucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacaccgucucccgccuccuccucaaccgcuucaccaugacccaccgccgccccaccaccgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12469 - RNA, 9873 nt, Artificial Sequence
  derived and/or modified CDS sequence (opt2) from DENV-3__JX669506__SS-prME
accuccuucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggccuacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12470 - RNA, 9873 nt, Artificial Sequence
  derived and/or modified CDS sequence (opt2) from DENV-3__JX669496__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcgccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacaccgucucccgccuccuccucaaccgcuucaccaugacccaccgccgccccaccaccgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12471 - RNA, 9873 nt, Artificial Sequence
  derived and/or modified CDS sequence (opt2) from DENV-3__JX669490__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12472 - RNA, 9873 nt, Artificial Sequence
  derived and/or modified CDS sequence (opt2) from DENV-3__JN406515__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacgagcagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacgucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccggcaucucccucuuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaugauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaaggcccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12473 - RNA, 9873 nt, Artificial Sequence
  derived and/or modified CDS sequence (opt2) from DENV-3__JN406514__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguuccucgaccucccccuccccuggaccuccggcgccaccaccgagcgccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucuccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaucuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcacaagcagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12474 - RNA, 9873 nt, Artificial Sequence
  derived and/or modified CDS sequence (opt2) from DENV-3__KT726340__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucaucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucgucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccgccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12475 - RNA, 9873 nt, Artificial Sequence
  derived and/or modified CDS sequence (opt2) from DENV-3__KT726345__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaucugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12476 - RNA, 9873 nt, Artificial Sequence
  derived and/or modified CDS sequence (opt2) from DENV-3__KT726349__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgaguccauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12477 - RNA, 9873 nt, Artificial Sequence
  derived and/or modified CDS sequence (opt2) from DENV-3__KT726347__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucgccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12478 - RNA, 9873 nt, Artificial Sequence
  derived and/or modified CDS sequence (opt2) from DENV-3__KT726352__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccgccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12479 - RNA, 9873 nt, Artificial Sequence
  derived and/or modified CDS sequence (opt2) from DENV-3__KT726356__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccuccucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12480 - RNA, 9873 nt, Artificial Sequence
  derived and/or modified CDS sequence (opt2) from DENV-3__KT726342__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12481 - RNA, 9873 nt, Artificial Sequence
  derived and/or modified CDS sequence (opt2) from DENV-3__KT726343__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12482 - RNA, 9873 nt, Artificial Sequence
  derived and/or modified CDS sequence (opt2) from DENV-3__KT726351__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgcaaggucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12483 - RNA, 9873 nt, Artificial Sequence
  derived and/or modified CDS sequence (opt2) from DENV-3__KT726360__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggaccccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12484 - RNA, 9873 nt, Artificial Sequence
  derived and/or modified CDS sequence (opt2) from DENV-3__KF041259__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaacgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggccgccucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagcgcaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaagaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggagcucgagggcgccaucugguga

SEQ ID NO: 12485 - RNA, 9873 nt, Artificial Sequence
  derived and/or modified CDS sequence (opt2) from DENV-3__KF041258__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaugacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagcgcaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacguccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggagcucgagggcgccaucugguga

SEQ ID NO: 12486 - RNA, 9873 nt, Artificial Sequence
  derived and/or modified CDS sequence (opt2) from DENV-3__KF041257__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagcgcaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccuccgcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggagcucgagggcgccaucugguga

SEQ ID NO: 12487 - RNA, 9873 nt, Artificial Sequence
  derived and/or modified CDS sequence (opt2) from DENV-3__KF041255__SS-prME
accucccucugccucaugaugauccuccccgccgcccucgccuuccaccucaccucccgcaacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagcgcaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaagaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggagcucgagggcgccaucugguga

SEQ ID NO: 12488 - RNA, 9873 nt, Artificial Sequence
  derived and/or modified CDS sequence (opt2) from DENV-3__KF041256__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccacccucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagcgcaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgagaagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaagaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccauccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggagcucgagggcgccaucugguga

SEQ ID NO: 12489 - RNA, 9873 nt, Artificial Sequence
  derived and/or modified CDS sequence (opt2) from DENV-3__KF041254__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgucgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggcgcaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagcgcaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccacccucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgcccgcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucuccaagcuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggagcucgagggcgccaucugguga

SEQ ID NO: 12490 - RNA, 9873 nt, Artificial Sequence
  derived and/or modified CDS sequence (opt2) from DENV-3__KX380841__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcaucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggacggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucaccauggccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12491 - RNA, 9873 nt, Artificial Sequence
  derived and/or modified CDS sequence (opt2) from DENV-3__KX380842__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcaucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgucggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccaugcucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggacggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucaccauggccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccauccccguccacuggguccccaccucccgcaccaccugguccauccacgcccaccaccaguggaugaccaccgaggacaugcucaccgucuggaaccgcgucuggaucgaggacaaccccuggauggaggacaagacccccaucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12492 - RNA, 9873 nt, Artificial Sequence
  derived and/or modified CDS sequence (opt2) from DENV-3__KX380839__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccaucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcucaccgagggcaaggucguccagcacgagaaccucaaguacaccgucaucaucaccguccacaccggcgaccagcaccaggucggcaacgagacccagggcgucaccgccgagaucaccccccaggccuccaccgucgaggccaucuuccgcuccuacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucugggccgcccucgucucccucaugugcuccaacaccaucuucacccucaccgucgccuggcgcaccgccacccucauccucgccggcaucucccuccuccccaugugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccccccaccucgcccaccgcacccgcaacgcccucgacaaccucgucaugcuccacaccuccgaguacggcggccgcgccuaccgccacgccgucgaggagcuccccgagaccauggagacccuccuccuccucggccucaugauccuccucaccggcggcgucaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucaucuccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacaugaucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12493 - RNA, 9873 nt, Artificial Sequence
  derived and/or modified CDS sequence (opt2) from DENV-3__KX380840__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccaucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcgcccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcucaccgagggcaaggucguccagcacgagaaccucaaguacaccgucaucaucaccguccacaccggcgaccagcaccaggucggcaacgagacccagggcgucaccgccgagaucaccccccaggccuccaccgucgaggccaucuuccgcuccuacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugcuccaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucaucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgcccuccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucugggccgcccucgucucccucaugugcuccaacaccaucuucacccucaccgucgccuggcgcaccgccacccucauccucgccggcaucucccuccuccccaugugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggcaaggagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgacuggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccccccaccucgcccaccgcacccgcaacgcccucgacaaccucgucaugcuccacaccuccgaguacggcggccgcgccuaccgccacgccgucgaggagcuccccgagaccauggagacccuccuccuccucggccucaugauccuccucaccggcggcgucaugcucuuccucaucuccggcaagggcgucggcaagaccuccaucggccucaucugcgucgucgccuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucaucuccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacaugaucucccgccuccuccucaaccgcuucaccaugaccuaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcacccccaagcccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaagaccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12494 - RNA, 9873 nt, Artificial Sequence
  derived and/or modified CDS sequence (opt2) from DENV-3__JF808121__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucuccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaccaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaucgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugaagcaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggaagacccucggccgcaacaagaagccccgccucugcccccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcuccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaugaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12495 - RNA, 9873 nt, Artificial Sequence
  derived and/or modified CDS sequence (opt2) from DENV-3__JF808120__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucaagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucaucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccaugaccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcuccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12496 - RNA, 9873 nt, Artificial Sequence
  derived and/or modified CDS sequence (opt2) from DENV-3__JF808119__SS-prME
accucccucugccucaugaugauccuccccaccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucauguucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucaucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgaggacugcguccucaagcccaucgacgaccgcuucgacaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccuccaccaguggaugaccaccgaggacaugaucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12497 - RNA, 9873 nt, Artificial Sequence
  derived and/or modified CDS sequence (opt2) from DENV-3__JF808118__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccauccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12498 - RNA, 9873 nt, Artificial Sequence
  derived and/or modified CDS sequence (opt2) from DENV-3__JF808127__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccucccucaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccgagcccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucaacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaagauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagcccaagcucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12499 - RNA, 9873 nt, Artificial Sequence
  derived and/or modified CDS sequence (opt2) from DENV-3__JF808124__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcaccuucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcucgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccugcguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagaugggcaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucauccucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucggcgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaucuacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcauguccuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12500 - RNA, 9873 nt, Artificial Sequence
  derived and/or modified CDS sequence (opt2) from DENV-3__JF808126__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguuccucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaguccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccgcccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccugcccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucgucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccagaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgccgcuggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccccuggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12501 - RNA, 9873 nt, Artificial Sequence
  derived and/or modified CDS sequence (opt2) from DENV-3__JF808125__SS-prME
accucccucugccucaugaugauccuccccgccgcccucgccuuccaccucaccucccgcgacggcgagccccgcaugaucgucggcgagaacgagcgcggcaagucccuccucuucaagaccgccuccggcaucaaccgccgcacccucaucgccauggaccucggcgagaugugcgaggagaccgagaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccgccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuccggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccuccgccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12502 - RNA, 9873 nt, Artificial Sequence
  derived and/or modified CDS sequence (opt2) from DENV-3__JF808129__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaccggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacugcaccaugggcguccucugccucgccauccucuucgaggacgucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaccaccgucgacgacgacggcaccaugcgcaucaaggacgacgagaccgagaacauccucaccguccuccucaagaccgcccucaccaucgucuccggcgucuuccccuacuccauccccgccacccuccucgucuggcacaccuggcagaagcagacccagcgcuccggcguccucugggacguccccuccccccccgagacccagaaggccgagcaggaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaccuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaccaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12503 - RNA, 9873 nt, Artificial Sequence
  derived and/or modified CDS sequence (opt2) from DENV-3__JF808123__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccaccucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucggccccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12504 - RNA, 9873 nt, Artificial Sequence
  derived and/or modified CDS sequence (opt2) from DENV-3__JF808128__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagcgcaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguuccucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaguccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccgcccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucgucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgccgcuggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccucccgcuccauguccuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12505 - RNA, 9873 nt, Artificial Sequence
  derived and/or modified CDS sequence (opt2) from DENV-3__JF808122__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaucaagugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccccccaccucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcauguccuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaacggcucccgcgccaucugguacauguggcucggcgcccgcuaccucgaguucgaggcccucggcuuccucaaggaguaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaccggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12506 - RNA, 9873 nt, Artificial Sequence
  derived and/or modified CDS sequence (opt2) from DENV-3__GQ466079__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuucuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucgagaaccucgagcucgacuucaccuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcauccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucauguccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccaguggcucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcucccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12507 - RNA, 9873 nt, Artificial Sequence
  derived and/or modified CDS sequence (opt2) from DENV-3__FJ898462__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagcgcggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaucgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12508 - RNA, 9873 nt, Artificial Sequence
  derived and/or modified CDS sequence (opt2) from DENV-3__KF955473__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccauccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12509 - RNA, 9873 nt, Artificial Sequence
  derived and/or modified CDS sequence (opt2) from DENV-3__FJ850079__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacgucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaccggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacgacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12510 - RNA, 9873 nt, Artificial Sequence
  derived and/or modified CDS sequence (opt2) from DENV-3__FJ850080__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucauguucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucaucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12511 - RNA, 9873 nt, Artificial Sequence
  derived and/or modified CDS sequence (opt2) from DENV-3__FJ850083__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagcgcgaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaccaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12512 - RNA, 9873 nt, Artificial Sequence
  derived and/or modified CDS sequence (opt2) from DENV-3__FJ850086__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcgccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaccguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucauguucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucaucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12513 - RNA, 9873 nt, Artificial Sequence
  derived and/or modified CDS sequence (opt2) from DENV-3__FJ850089__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggucauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaaggucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccagaucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12514 - RNA, 9873 nt, Artificial Sequence
  derived and/or modified CDS sequence (opt2) from DENV-3__FJ850092__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggucauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgucaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaaggucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaucgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12515 - RNA, 9873 nt, Artificial Sequence
  derived and/or modified CDS sequence (opt2) from DENV-3__FJ850094__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccggcacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggacgagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacaccuucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacggcaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagauccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12516 - RNA, 9873 nt, Artificial Sequence
  derived and/or modified CDS sequence (opt2) from DENV-3__FJ898446__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgagaccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga
